United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 3

SEQ ID NO: 2605 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2606 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2607 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2608 - DNA, 3354 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2609 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2610 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2611 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2612 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2613 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2614 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2615 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2616 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2617 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2618 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2619 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2620 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2621 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2622 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2623 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2624 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2625 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2626 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2627 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2628 - DNA, 3480 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2629 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2630 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2631 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2632 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2633 - DNA, 2982 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2634 - DNA, 3408 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2635 - DNA, 3465 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2636 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2637 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2638 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2639 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2640 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2641 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2642 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2643 - DNA, 3354 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2644 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2645 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2646 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2647 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2648 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2649 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2650 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2651 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2652 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2653 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2654 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2655 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2656 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2657 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2658 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2659 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2660 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2661 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2662 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2663 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2664 - DNA, 2964 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2665 - DNA, 2769 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2666 - DNA, 2982 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2667 - DNA, 2979 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2668 - DNA, 3435 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2669 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2670 - DNA, 2964 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2671 - DNA, 2784 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2672 - DNA, 3450 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2673 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2674 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2675 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2676 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2677 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2678 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2679 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2680 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2681 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2682 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2683 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2684 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2685 - DNA, 2958 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2686 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2687 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2688 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2689 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2690 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2691 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2692 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2693 - DNA, 3282 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2694 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2695 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2696 - DNA, 3336 bp, Artificial Sequence; identical to SEQ ID NO: 2581
  Synthetic Polynucleotide encoding a CAR with optional accessory module(s)

SEQ ID NO: 2697 - DNA, 3354 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2698 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2699 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2700 - DNA, 2985 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2701 - DNA, 3474 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2702 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2703 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2704 - DNA, 3321 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2705 - DNA, 3324 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2706 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2707 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2708 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2709 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2710 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2711 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2712 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2713 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2714 - DNA, 3036 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2715 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2716 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2717 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2718 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2719 - DNA, 3039 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2720 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2721 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2722 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2723 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2724 - DNA, 3369 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2725 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2726 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2727 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2728 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2729 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2730 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2731 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2732 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2733 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2734 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2735 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2736 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2737 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2738 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2739 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2740 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2741 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2742 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2743 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2744 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2745 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2746 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2747 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2748 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2749 - DNA, 3099 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2750 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2751 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2752 - DNA, 3273 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2753 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2754 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2755 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2756 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2757 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2758 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2759 - DNA, 3354 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2760 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2761 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2762 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2763 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2764 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2765 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2766 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2767 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2768 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2769 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2770 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2771 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2772 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2773 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2774 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2775 - DNA, 3327 bp, Artificial Sequence; identical to SEQ ID NO: 2774
  Synthetic Polynucleotide encoding a CAR with optional accessory module(s)

SEQ ID NO: 2776 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2777 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2778 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2779 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2780 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2781 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2782 - DNA, 3333 bp, Artificial Sequence; identical to SEQ ID NO: 2776
  Synthetic Polynucleotide encoding a CAR with optional accessory module(s)

SEQ ID NO: 2783 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2784 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2785 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2786 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2787 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2788 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2789 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2790 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2791 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2792 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2793 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2794 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggaattcgaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2795 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2796 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2797 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2798 - DNA, 2952 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2799 - DNA, 2949 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2800 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2801 - DNA, 2943 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2802 - DNA, 2961 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2803 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2804 - DNA, 2979 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2805 - DNA, 2952 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2806 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2807 - DNA, 2946 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2808 - DNA, 2982 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2809 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2810 - DNA, 2952 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2811 - DNA, 2955 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2812 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2813 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaacagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2814 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2815 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2816 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2817 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2818 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtacagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2819 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2820 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2821 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2822 - DNA, 3300 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2823 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2824 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2825 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2826 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2827 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2828 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2829 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2830 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2831 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2832 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2833 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2834 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2835 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2836 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2837 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2838 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2839 - DNA, 3297 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2840 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2841 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2842 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2843 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2844 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2845 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2846 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2847 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2848 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2849 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2850 - DNA, 3657 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2851 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2852 - DNA, 3285 bp, Artificial Sequence; identical to SEQ ID NO: 2851
  Synthetic Polynucleotide encoding a CAR with optional accessory module(s)

SEQ ID NO: 2853 - DNA, 3126 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2854 - DNA, 3126 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2855 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2856 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2857 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2858 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2859 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2860 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2861 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2862 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2863 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2864 - DNA, 3282 bp, Artificial Sequence; identical to SEQ ID NO: 2860
  Synthetic Polynucleotide encoding a CAR with optional accessory module(s)

SEQ ID NO: 2865 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2866 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2867 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2868 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2869 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2870 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2871 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2872 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2873 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2874 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2875 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2876 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2877 - DNA, 3369 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2878 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2879 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2880 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2881 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2882 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2883 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2884 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2885 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2886 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2887 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2888 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2889 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2890 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2891 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2892 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2893 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2894 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2895 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2896 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2897 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2898 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2899 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2900 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2901 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2902 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2903 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2904 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2905 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2906 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2907 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2908 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2909 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2910 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2911 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2912 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2913 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2914 - DNA, 3303 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2915 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2916 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2917 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2918 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2919 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2920 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2921 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2922 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2923 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2924 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2925 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2926 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2927 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2928 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2929 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2930 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2931 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2932 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2933 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2934 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2935 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2936 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2937 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2938 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2939 - DNA, 2931 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2940 - DNA, 3357 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2941 - DNA, 3414 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2942 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2943 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2944 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2945 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2946 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2947 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2948 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2949 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2950 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2951 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2952 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2953 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2954 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2955 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2956 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2957 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2958 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2959 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2960 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2961 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2962 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2963 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2964 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2965 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2966 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2967 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2968 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2969 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2970 - DNA, 2913 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2971 - DNA, 2718 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2972 - DNA, 2931 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2973 - DNA, 2928 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2974 - DNA, 3384 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2975 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2976 - DNA, 2913 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2977 - DNA, 2733 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2978 - DNA, 3399 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2979 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2980 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2981 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2982 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2983 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2984 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2985 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2986 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2987 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2988 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2989 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2990 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2991 - DNA, 2907 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2992 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2993 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2994 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2995 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2996 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2997 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2998 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2999 - DNA, 3231 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3000 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3001 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3002 - DNA, 3285 bp, Artificial Sequence; identical to SEQ ID NO: 2887
  Synthetic Polynucleotide encoding a CAR with optional accessory module(s)

SEQ ID NO: 3003 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3004 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3005 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3006 - DNA, 2934 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3007 - DNA, 3423 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3008 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3009 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3010 - DNA, 3270 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3011 - DNA, 3273 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3012 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3013 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3014 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3015 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3016 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3017 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3018 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3019 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3020 - DNA, 2985 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3021 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3022 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3023 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3024 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3025 - DNA, 2988 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3026 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3027 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3028 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3029 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3030 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3031 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3032 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3033 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3034 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3035 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3036 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3037 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3038 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3039 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3040 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3041 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3042 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3043 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3044 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3045 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3046 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3047 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3048 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3049 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3050 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3051 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3052 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3053 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3054 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3055 - DNA, 3048 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3056 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3057 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3058 - DNA, 3222 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3059 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3060 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3061 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3062 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3063 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3064 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3065 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3066 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3067 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3068 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3069 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3070 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3071 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3072 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3073 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3074 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3075 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3076 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3077 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3078 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3079 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3080 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3081 - DNA, 3276 bp, Artificial Sequence; identical to SEQ ID NO: 3080
  Synthetic Polynucleotide encoding a CAR with optional accessory module(s)

SEQ ID NO: 3082 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3083 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3084 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3085 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3086 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3087 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3088 - DNA, 3282 bp, Artificial Sequence; identical to SEQ ID NO: 3082
  Synthetic Polynucleotide encoding a CAR with optional accessory module(s)

SEQ ID NO: 3089 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3090 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3091 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3092 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3093 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3094 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3095 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3096 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3097 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3098 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3099 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3100 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggaattcgaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3101 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3102 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3103 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3104 - DNA, 2901 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3105 - DNA, 2898 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3106 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3107 - DNA, 2892 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3108 - DNA, 2910 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3109 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3110 - DNA, 2928 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3111 - DNA, 2901 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3112 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3113 - DNA, 2895 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3114 - DNA, 2931 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3115 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3116 - DNA, 2901 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3117 - DNA, 2904 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3118 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3119 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaacagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3120 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3121 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3122 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3123 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3124 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3125 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3126 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3127 - DNA, 3258 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3128 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3129 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3130 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3131 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3132 - DNA, 3255 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3133 - DNA, 4197 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3134 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3135 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3136 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3137 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3138 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3139 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3140 - DNA, 3615 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3141 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3142 - DNA, 3243 bp, Artificial Sequence; identical to SEQ ID NO: 3141
  Synthetic Polynucleotide encoding a CAR with optional accessory module(s)

SEQ ID NO: 3143 - DNA, 3705 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3144 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3145 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3146 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3147 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3148 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3149 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3150 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3151 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3152 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3153 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3154 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3155 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3156 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3157 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3158 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3159 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3160 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3161 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3162 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3163 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3164 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3165 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3166 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3167 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3168 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3169 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3170 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3171 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3172 - DNA, 3261 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3173 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3174 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3175 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3176 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3177 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3178 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3179 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3180 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3181 - DNA, 3273 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3182 - DNA, 3504 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3183 - DNA, 3504 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3184 - DNA, 3654 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3185 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3186 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3187 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3188 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3189 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3190 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3191 - DNA, 3309 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3192 - DNA, 3300 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3193 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3194 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3195 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3196 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3197 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3198 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3199 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3200 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3201 - DNA, 3162 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3202 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3203 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3204 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3205 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3206 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3207 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3208 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3209 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3210 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3211 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3212 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3213 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3214 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3215 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3216 - DNA, 3312 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3217 - DNA, 3270 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3218 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3219 - DNA, 3285 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3220 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3221 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3222 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3223 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3224 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3225 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3226 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3227 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3228 - DNA, 3198 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3229 - DNA, 3636 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3230 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3231 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3232 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3233 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3234 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3235 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3236 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3237 - DNA, 3189 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3238 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3239 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3240 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3241 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3242 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3243 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3244 - DNA, 3309 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3245 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3246 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3247 - DNA, 3231 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3248 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3249 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3250 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3251 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3252 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3253 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3254 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3255 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3256 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactgttcaaccaggaggtccaaataccactgacggagagttactgcgggccatgtccgaaaaattggatctgctataaaaacaactgctatcagtttttcgacgagagtaagaactggtacgaaagccaggcgagctgcatgtcccaaaatgcttccttgttgaaagtttactccaaagaggatcaagacctgctgaagctggtcaaatcttaccactggatgggtcttgttcacatccccactaacggttcctggcaatgggaagatggatctatacttagccctaacttgttgacgataattgaaatgcagaaaggcgactgtgcactttacgcttcctctttcaaaggctacattgagaattgttcaactccgaatacatatatctgtatgcagaggaccgttggcggtggagggagcggaggaggaggtgacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3257 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3258 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3259 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3260 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3261 - DNA, 3429 bp, Artificial Sequence
  Synthetic Polynucleotide encoding a CAR with optional accessory module(s)
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3262 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3263 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3264 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3265 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3266 - DNA, 3276 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3267 - DNA, 3198 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3268 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3269 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3270 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3271 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3272 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3273 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3274 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3275 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3276 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3277 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3278 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3279 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3280 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3281 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3282 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3283 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3284 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3285 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3286 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3287 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3288 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3289 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3290 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3291 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3292 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3293 - DNA, 3180 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3294 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3295 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3296 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3297 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3298 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3299 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3300 - DNA, 3258 bp, Artificial Sequence; identical to SEQ ID NO: 3298
  Synthetic Polynucleotide encoding a CAR with optional accessory module(s)

SEQ ID NO: 3301 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3302 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3303 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3304 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3305 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3306 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3307 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3308 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3309 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3310 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3311 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3312 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3313 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3314 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3315 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3316 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3317 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3318 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3319 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgtcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3320 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccgcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3321 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccgcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3322 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccgcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3323 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 3324 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3325 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3326 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3327 - DNA, 3408 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3328 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3329 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3330 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3331 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3332 - DNA, 3405 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3333 - DNA, 4347 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3334 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3335 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3336 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3337 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3338 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3339 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3340 - DNA, 3765 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3341 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3342 - DNA, 3393 bp, Artificial Sequence; identical to SEQ ID NO: 3341
  Synthetic Polynucleotide encoding a CAR with optional accessory module(s)

SEQ ID NO: 3343 - DNA, 3855 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3344 - DNA, 3624 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3345 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3346 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3347 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3348 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3349 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3350 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3351 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3352 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3353 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3354 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3355 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3356 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3357 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3358 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3359 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3360 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3361 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3362 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3363 - DNA, 3369 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3364 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3365 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3366 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3367 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3368 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3369 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3370 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3371 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3372 - DNA, 3411 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3373 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3374 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3375 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3376 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3377 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3378 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3379 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3380 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3381 - DNA, 3423 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3382 - DNA, 3654 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3383 - DNA, 3654 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3384 - DNA, 3804 bp, Artificial Sequence
  Synthetic Polynucleotide encoding a CAR with optional accessory module(s)
atggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcgccaccatggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3385 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3386 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3387 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3388 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3389 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3390 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3391 - DNA, 3459 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3392 - DNA, 3450 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3393 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3394 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3395 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3396 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3397 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3398 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3399 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3400 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3401 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3402 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3403 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3404 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3405 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3406 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3407 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3408 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3409 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3410 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3411 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3412 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3413 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3414 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3415 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3416 - DNA, 3462 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3417 - DNA, 3420 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3418 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3419 - DNA, 3435 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3420 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3421 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3422 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3423 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3424 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3425 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3426 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3427 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3428 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3429 - DNA, 3786 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3430 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3431 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3432 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3433 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3434 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3435 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3436 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3437 - DNA, 3339 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3438 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3439 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3440 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3441 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3442 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3443 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3444 - DNA, 3459 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3445 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3446 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3447 - DNA, 3381 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3448 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3449 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3450 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3451 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3452 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3453 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3454 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3455 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3456 - DNA, 3573 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactgttcaaccaggaggtccaaataccactgacggagagttactgcgggccatgtccgaaaaattggatctgctataaaaacaactgctatcagtttttcgacgagagtaagaactggtacgaaagccaggcgagctgcatgtcccaaaatgcttccttgttgaaagtttactccaaagaggatcaagacctgctgaagctggtcaaatcttaccactggatgggtcttgttcacatccccactaacggttcctggcaatgggaagatggatctatacttagccctaacttgttgacgataattgaaatgcagaaaggcgactgtgcactttacgcttcctctttcaaaggctacattgagaattgttcaactccgaatacatatatctgtatgcagaggaccgttggcggtggagggagcggaggaggaggtgacacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3457 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3458 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3459 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3460 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3461 - DNA, 3579 bp, Artificial Sequence
  Synthetic Polynucleotide encoding a CAR with optional accessory module(s)
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3462 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3463 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3464 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3465 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3466 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3467 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3468 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3469 - DNA, 3369 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3470 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3471 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3472 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3473 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3474 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3475 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3476 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3477 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3478 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3479 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3480 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3481 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3482 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3483 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3484 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3485 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3486 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3487 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3488 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3489 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3490 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3491 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3492 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3493 - DNA, 3330 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3494 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3495 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3496 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga
